United States Patent 12,297,469 (METHODS AND COMPOSITIONS FOR INHIBITING ADAM10 BIOLOGICAL ACTIVITIES) - sequence listing, part 2

SEQ ID NO: 7896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 7897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 7898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 7899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 7900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 7901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 7902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 7903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 7904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 7905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 7906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 7907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 7908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 7909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 7910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 7911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 7912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 7913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 7914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 7915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 7916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 7917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 7918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 7919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 7920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 7921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 7922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 7923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 7924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 7925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 7926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 7927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 7928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 7929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 7930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 7931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 7932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 7933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 7934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 7935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 7936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 7937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 7938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 7939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 7940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 7941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 7942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 7943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 7944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 7945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 7946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 7947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 7948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 7949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 7950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 7951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 7952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 7953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 7954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 7955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 7956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 7957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 7958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 7959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 7960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 7961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 7962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 7963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 7964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 7965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 7966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 7967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 7968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 7969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 7970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 7971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 7972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 7973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 7974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 7975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 7976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 7977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 7978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 7979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 7980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 7981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 7982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 7983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 7984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 7985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 7986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 7987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 7988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 7989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 7990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 7991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 7992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 7993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 7994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 7995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 7996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 7997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 7998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 7999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 8000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 8001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 8002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 8003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 8004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 8005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 8006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 8007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 8008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 8009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 8010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 8011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 8012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 8013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 8014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 8015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 8016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 8017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 8018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 8019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 8020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 8021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 8022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 8023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 8024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 8025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 8026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 8027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 8028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 8029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 8030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 8031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 8032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 8033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 8034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 8035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 8036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 8037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 8038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 8039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 8040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 8041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 8042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 8043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 8044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 8045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 8046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 8047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 8048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 8049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 8050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 8051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 8052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 8053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 8054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 8055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 8056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 8057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 8058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 8059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 8060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 8061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 8062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 8063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 8064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 8065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 8066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 8067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 8068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 8069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 8070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 8071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 8072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 8073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 8074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 8075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 8076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 8077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 8078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 8079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 8080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 8081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 8082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 8083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 8084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 8085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 8086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 8087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 8088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 8089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 8090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 8091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 8092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 8093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 8094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 8095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 8096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 8097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 8098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 8099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 8100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 8101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 8102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 8103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 8104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 8105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 8106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 8107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 8108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 8109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 8110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 8111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 8112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 8113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 8114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 8115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 8116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 8117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 8118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 8119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 8120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 8121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 8122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 8123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 8124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 8125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 8126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 8127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 8128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 8129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 8130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 8131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 8132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 8133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 8134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 8135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 8136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 8137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 8138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 8139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 8140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 8141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 8142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 8143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 8144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 8145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 8146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 8147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 8148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 8149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 8150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 8151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 8152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 8153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 8154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 8155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 8156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 8157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 8158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 8159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 8160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 8161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 8162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 8163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 8164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 8165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 8166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 8167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 8168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 8169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 8170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 8171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 8172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 8173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 8174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 8175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 8176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 8177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 8178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 8179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 8180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 8181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 8182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 8183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 8184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 8185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 8186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 8187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 8188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 8189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 8190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 8191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 8192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 8193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 8194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 8195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 8196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 8197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 8198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 8199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 8200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 8201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 8202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 8203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 8204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 8205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 8206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 8207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 8208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 8209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 8210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 8211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 8212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 8213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 8214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 8215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 8216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 8217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 8218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 8219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 8220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 8221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 8222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 8223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 8224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 8225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 8226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 8227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 8228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 8229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 8230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 8231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 8232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 8233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 8234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 8235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 8236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 8237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 8238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 8239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 8240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 8241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 8242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 8243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 8244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 8245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 8246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 8247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 8248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 8249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 8250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 8251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 8252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 8253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 8254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 8255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 8256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 8257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 8258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 8259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 8260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 8261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 8262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 8263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 8264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 8265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 8266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 8267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 8268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 8269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 8270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 8271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 8272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 8273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 8274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 8275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 8276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 8277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 8278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 8279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 8280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 8281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 8282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 8283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 8284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 8285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 8286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 8287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 8288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 8289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 8290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 8291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 8292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 8293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 8294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 8295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 8296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 8297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 8298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 8299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 8300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 8301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 8302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 8303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 8304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 8305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 8306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 8307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 8308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 8309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 8310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 8311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 8312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 8313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 8314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 8315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 8316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 8317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 8318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 8319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 8320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 8321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 8322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 8323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 8324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 8325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 8326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 8327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 8328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 8329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 8330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 8331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 8332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 8333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 8334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 8335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 8336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 8337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 8338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 8339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 8340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 8341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 8342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 8343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 8344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 8345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 8346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 8347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 8348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 8349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 8350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 8351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 8352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 8353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 8354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 8355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 8356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 8357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 8358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 8359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 8360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 8361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 8362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 8363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 8364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 8365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 8366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 8367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 8368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 8369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 8370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 8371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 8372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 8373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 8374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 8375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 8376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 8377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 8378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 8379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 8380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 8381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 8382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 8383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 8384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 8385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 8386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 8387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 8388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 8389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 8390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 8391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 8392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 8393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 8394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 8395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 8396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 8397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 8398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 8399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 8400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 8401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 8402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 8403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 8404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 8405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 8406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 8407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 8408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 8409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 8410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 8411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 8412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 8413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 8414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 8415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 8416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 8417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 8418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 8419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 8420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 8421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 8422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 8423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 8424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 8425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 8426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 8427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 8428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 8429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 8430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 8431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 8432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 8433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 8434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 8435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 8436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 8437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 8438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 8439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 8440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 8441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 8442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 8443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 8444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 8445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 8446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 8447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 8448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 8449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 8450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 8451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 8452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 8453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 8454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 8455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 8456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 8457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 8458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 8459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 8460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 8461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 8462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 8463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 8464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 8465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 8466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 8467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 8468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 8469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 8470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 8471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 8472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 8473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 8474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 8475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 8476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 8477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 8478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 8479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 8480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 8481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 8482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 8483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 8484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 8485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 8486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 8487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 8488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 8489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 8490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 8491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 8492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 8493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 8494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 8495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 8496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 8497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 8498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 8499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 8500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 8501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 8502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 8503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 8504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 8505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 8506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 8507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 8508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 8509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 8510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 8511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 8512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 8513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 8514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 8515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 8516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 8517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 8518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 8519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 8520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 8521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 8522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 8523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 8524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 8525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 8526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 8527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 8528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 8529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 8530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 8531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 8532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 8533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 8534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 8535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 8536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 8537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 8538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 8539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 8540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 8541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 8542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 8543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 8544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 8545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 8546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 8547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 8548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 8549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 8550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 8551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 8552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 8553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 8554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 8555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 8556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 8557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 8558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 8559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 8560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 8561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 8562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 8563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 8564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 8565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 8566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 8567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 8568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 8569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 8570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 8571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 8572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 8573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 8574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 8575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 8576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 8577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 8578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 8579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 8580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 8581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 8582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 8583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 8584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 8585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 8586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 8587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 8588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 8589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 8590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 8591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 8592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 8593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 8594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 8595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 8596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 8597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 8598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 8599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 8600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 8601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 8602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 8603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 8604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 8605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 8606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 8607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 8608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 8609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 8610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 8611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 8612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 8613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 8614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 8615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 8616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 8617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 8618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 8619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 8620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 8621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 8622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 8623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 8624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 8625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 8626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 8627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 8628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 8629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 8630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 8631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 8632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 8633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 8634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 8635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 8636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 8637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 8638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 8639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 8640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 8641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 8642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 8643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 8644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 8645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 8646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 8647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 8648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 8649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 8650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 8651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 8652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 8653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 8654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 8655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 8656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 8657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 8658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 8659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 8660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 8661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 8662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 8663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 8664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 8665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 8666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 8667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 8668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 8669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 8670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 8671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 8672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 8673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 8674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 8675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 8676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 8677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 8678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 8679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 8680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 8681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 8682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 8683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 8684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 8685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 8686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 8687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 8688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 8689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 8690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 8691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 8692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 8693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 8694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 8695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 8696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 8697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 8698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 8699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 8700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 8701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 8702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 8703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 8704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 8705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 8706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 8707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 8708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 8709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 8710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 8711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 8712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 8713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 8714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 8715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 8716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 8717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 8718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 8719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 8720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 8721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 8722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 8723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 8724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 8725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 8726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 8727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 8728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 8729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 8730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 8731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 8732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 8733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 8734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 8735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 8736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 8737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 8738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 8739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 8740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 8741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 8742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 8743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 8744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 8745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 8746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 8747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 8748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 8749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 8750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 8751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 8752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 8753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 8754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 8755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 8756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 8757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 8758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 8759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 8760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 8761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 8762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 8763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 8764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 8765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 8766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 8767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 8768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 8769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 8770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 8771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 8772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 8773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 8774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 8775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 8776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 8777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 8778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 8779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 8780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 8781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 8782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 8783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 8784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 8785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 8786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 8787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 8788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 8789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 8790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 8791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 8792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 8793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 8794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 8795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 8796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 8797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 8798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 8799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 8800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 8801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 8802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 8803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 8804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 8805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 8806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 8807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 8808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 8809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 8810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 8811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 8812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 8813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 8814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 8815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 8816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 8817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 8818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 8819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 8820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 8821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 8822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 8823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 8824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 8825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 8826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 8827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 8828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 8829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 8830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 8831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 8832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 8833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 8834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 8835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 8836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 8837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 8838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 8839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 8840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 8841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 8842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 8843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 8844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 8845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 8846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 8847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 8848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 8849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 8850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 8851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 8852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 8853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 8854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 8855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 8856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 8857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 8858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 8859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 8860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 8861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 8862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 8863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 8864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 8865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 8866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 8867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 8868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 8869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 8870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 8871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 8872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 8873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 8874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 8875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 8876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 8877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 8878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 8879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 8880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 8881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 8882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 8883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 8884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 8885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 8886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 8887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 8888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 8889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 8890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 8891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 8892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 8893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 8894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 8895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 8896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 8897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 8898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 8899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 8900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 8901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 8902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 8903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 8904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 8905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 8906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 8907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 8908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 8909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 8910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 8911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 8912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 8913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 8914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 8915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 8916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 8917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 8918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 8919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 8920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 8921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 8922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 8923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 8924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 8925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 8926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 8927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 8928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 8929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 8930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 8931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 8932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 8933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 8934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 8935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 8936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 8937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 8938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 8939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 8940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 8941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 8942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 8943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 8944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 8945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 8946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 8947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 8948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 8949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 8950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 8951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 8952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 8953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 8954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 8955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 8956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 8957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 8958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 8959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 8960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 8961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 8962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 8963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 8964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 8965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 8966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 8967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 8968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 8969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 8970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 8971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 8972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 8973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 8974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 8975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 8976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 8977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 8978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 8979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 8980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 8981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 8982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 8983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 8984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 8985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 8986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 8987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 8988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 8989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 8990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 8991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 8992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 8993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 8994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 8995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 8996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 8997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 8998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 8999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 9000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 9001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 9002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 9003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 9004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 9005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 9006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 9007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 9008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 9009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 9010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 9011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 9012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 9013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 9014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 9015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 9016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 9017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 9018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 9019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 9020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 9021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 9022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 9023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 9024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 9025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 9026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 9027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 9028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 9029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 9030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 9031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 9032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 9033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 9034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 9035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 9036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 9037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 9038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 9039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 9040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 9041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 9042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 9043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 9044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 9045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 9046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 9047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 9048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 9049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 9050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 9051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 9052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 9053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 9054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 9055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 9056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 9057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 9058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 9059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 9060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 9061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 9062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 9063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 9064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 9065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 9066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 9067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 9068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 9069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 9070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 9071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 9072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 9073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 9074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 9075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 9076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 9077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 9078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 9079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 9080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 9081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 9082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 9083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 9084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 9085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 9086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 9087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 9088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 9089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 9090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 9091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 9092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 9093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 9094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 9095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 9096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 9097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 9098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 9099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 9100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 9101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 9102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 9103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 9104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 9105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 9106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 9107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 9108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 9109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 9110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 9111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 9112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 9113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 9114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 9115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 9116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 9117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 9118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 9119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 9120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 9121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 9122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 9123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 9124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 9125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 9126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 9127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 9128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 9129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 9130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 9131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 9132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 9133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 9134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 9135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 9136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 9137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 9138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 9139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 9140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 9141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 9142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 9143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 9144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 9145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 9146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 9147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 9148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 9149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 9150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 9151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 9152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 9153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 9154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 9155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 9156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 9157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 9158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 9159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 9160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 9161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 9162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 9163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 9164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 9165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 9166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 9167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 9168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 9169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 9170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 9171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 9172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 9173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 9174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 9175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 9176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 9177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 9178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 9179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 9180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 9181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 9182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 9183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 9184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 9185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 9186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 9187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 9188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 9189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 9190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 9191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 9192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 9193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 9194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 9195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 9196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 9197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 9198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 9199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 9200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 9201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 9202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 9203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 9204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 9205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 9206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 9207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 9208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 9209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 9210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 9211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 9212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 9213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 9214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 9215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 9216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 9217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 9218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 9219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 9220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 9221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 9222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 9223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 9224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 9225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 9226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 9227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 9228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 9229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 9230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 9231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 9232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 9233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 9234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 9235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 9236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 9237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 9238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 9239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 9240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 9241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 9242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 9243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 9244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 9245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 9246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 9247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 9248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 9249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 9250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 9251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 9252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 9253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 9254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 9255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 9256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 9257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 9258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 9259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 9260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 9261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 9262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 9263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 9264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 9265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 9266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 9267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 9268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 9269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 9270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 9271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 9272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 9273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 9274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 9275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 9276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 9277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 9278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 9279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 9280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 9281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 9282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 9283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 9284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 9285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 9286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 9287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 9288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 9289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 9290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 9291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 9292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 9293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 9294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 9295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 9296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 9297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 9298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 9299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 9300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 9301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 9302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 9303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 9304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 9305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 9306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 9307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 9308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 9309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 9310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 9311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 9312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 9313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 9314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 9315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 9316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 9317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 9318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 9319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 9320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 9321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 9322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 9323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 9324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 9325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 9326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 9327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 9328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 9329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 9330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 9331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 9332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 9333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 9334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 9335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 9336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 9337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 9338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 9339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 9340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 9341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 9342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 9343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 9344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 9345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 9346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 9347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 9348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 9349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 9350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 9351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 9352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 9353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 9354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 9355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 9356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 9357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 9358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 9359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 9360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 9361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 9362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 9363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 9364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 9365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 9366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 9367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 9368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 9369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 9370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 9371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 9372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 9373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 9374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 9375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 9376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 9377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 9378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 9379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 9380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 9381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 9382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 9383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 9384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 9385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 9386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 9387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 9388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 9389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 9390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 9391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 9392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 9393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 9394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 9395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 9396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 9397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 9398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 9399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 9400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 9401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 9402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 9403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 9404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 9405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 9406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 9407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 9408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 9409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 9410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 9411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 9412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 9413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 9414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 9415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 9416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 9417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 9418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 9419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 9420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 9421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 9422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 9423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 9424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 9425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 9426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 9427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 9428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 9429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 9430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 9431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 9432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 9433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 9434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 9435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 9436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 9437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 9438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 9439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 9440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 9441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 9442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 9443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 9444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 9445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 9446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 9447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 9448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 9449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 9450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 9451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 9452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 9453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 9454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 9455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 9456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 9457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 9458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 9459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 9460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 9461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 9462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 9463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 9464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 9465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 9466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 9467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 9468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 9469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 9470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 9471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 9472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 9473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 9474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 9475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 9476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 9477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 9478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 9479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 9480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 9481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 9482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 9483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 9484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 9485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 9486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 9487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 9488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 9489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 9490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 9491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 9492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 9493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 9494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 9495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 9496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 9497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 9498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 9499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 9500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 9501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 9502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 9503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 9504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 9505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 9506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 9507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 9508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 9509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 9510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 9511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 9512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 9513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 9514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 9515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 9516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 9517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 9518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 9519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 9520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 9521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 9522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 9523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 9524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 9525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 9526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 9527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 9528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 9529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 9530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 9531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 9532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 9533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 9534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 9535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 9536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 9537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 9538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 9539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 9540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 9541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 9542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 9543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 9544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 9545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 9546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 9547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 9548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 9549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 9550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 9551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 9552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 9553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 9554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 9555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 9556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 9557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 9558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 9559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 9560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 9561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 9562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 9563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 9564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 9565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 9566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 9567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 9568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 9569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 9570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 9571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 9572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 9573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 9574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 9575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 9576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 9577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 9578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 9579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 9580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 9581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 9582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 9583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 9584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 9585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 9586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 9587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 9588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 9589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 9590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 9591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 9592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 9593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 9594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 9595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 9596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 9597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 9598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 9599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 9600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 9601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 9602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 9603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 9604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 9605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 9606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 9607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 9608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 9609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 9610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 9611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 9612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 9613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 9614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 9615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 9616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 9617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 9618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 9619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 9620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 9621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 9622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 9623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 9624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 9625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 9626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 9627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 9628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 9629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 9630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 9631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 9632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 9633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 9634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 9635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 9636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 9637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 9638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 9639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 9640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 9641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 9642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 9643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 9644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 9645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 9646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 9647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 9648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 9649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 9650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 9651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 9652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 9653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 9654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 9655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 9656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 9657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 9658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 9659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 9660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 9661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 9662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 9663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 9664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 9665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 9666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 9667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 9668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 9669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 9670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 9671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 9672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 9673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 9674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 9675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 9676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 9677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 9678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 9679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 9680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 9681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 9682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 9683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 9684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 9685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 9686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 9687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 9688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 9689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 9690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 9691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 9692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 9693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 9694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 9695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 9696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 9697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 9698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 9699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 9700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 9701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 9702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 9703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 9704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 9705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 9706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 9707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 9708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 9709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 9710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 9711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 9712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 9713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 9714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 9715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 9716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 9717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 9718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 9719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 9720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 9721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 9722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 9723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 9724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 9725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 9726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 9727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 9728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 9729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 9730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 9731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 9732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 9733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 9734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 9735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 9736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 9737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 9738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 9739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 9740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 9741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 9742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 9743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 9744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 9745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 9746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 9747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 9748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 9749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 9750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 9751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 9752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 9753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 9754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 9755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 9756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 9757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 9758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 9759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 9760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 9761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 9762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 9763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 9764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 9765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 9766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 9767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 9768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 9769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 9770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 9771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 9772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 9773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 9774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 9775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 9776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 9777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 9778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 9779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 9780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 9781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 9782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 9783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 9784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 9785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 9786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 9787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 9788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 9789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 9790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 9791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 9792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 9793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 9794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 9795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 9796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 9797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 9798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 9799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 9800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 9801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 9802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 9803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 9804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 9805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 9806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 9807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 9808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 9809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 9810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 9811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 9812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 9813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 9814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 9815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 9816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 9817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 9818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 9819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 9820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 9821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 9822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 9823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 9824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 9825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 9826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 9827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 9828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 9829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 9830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 9831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 9832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 9833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 9834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 9835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 9836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 9837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 9838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 9839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 9840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 9841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 9842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 9843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 9844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 9845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 9846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 9847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 9848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 9849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 9850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 9851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 9852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 9853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 9854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 9855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 9856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 9857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 9858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 9859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 9860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 9861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 9862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 9863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 9864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 9865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 9866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 9867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 9868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 9869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 9870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 9871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 9872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 9873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 9874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 9875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 9876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 9877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 9878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 9879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 9880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 9881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 9882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 9883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 9884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 9885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 9886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 9887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 9888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 9889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 9890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 9891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 9892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 9893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 9894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 9895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 9896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 9897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 9898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 9899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 9900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 9901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 9902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 9903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 9904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 9905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 9906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 9907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 9908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 9909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 9910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 9911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 9912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 9913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 9914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 9915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 9916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 9917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 9918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 9919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 9920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 9921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 9922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 9923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 9924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 9925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 9926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 9927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 9928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 9929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 9930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 9931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 9932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 9933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 9934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 9935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 9936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 9937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 9938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 9939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 9940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 9941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 9942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 9943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 9944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 9945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 9946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 9947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 9948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 9949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 9950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 9951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 9952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 9953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 9954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 9955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 9956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 9957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 9958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 9959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 9960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 9961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 9962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 9963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 9964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 9965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 9966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 9967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 9968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 9969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 9970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 9971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 9972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 9973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 9974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 9975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 9976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 9977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 9978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 9979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 9980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 9981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 9982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 9983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 9984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 9985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 9986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 9987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 9988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 9989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 9990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 9991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 9992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 9993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 9994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 9995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 9996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 9997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 9998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 9999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 10000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 10001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 10002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 10003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 10004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 10005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 10006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 10007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 10008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 10009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 10010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 10011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 10012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 10013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 10014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 10015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 10016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 10017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 10018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 10019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 10020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 10021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 10022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 10023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 10024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 10025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 10026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 10027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 10028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 10029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 10030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 10031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 10032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 10033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 10034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 10035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 10036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 10037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 10038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 10039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 10040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 10041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 10042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 10043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 10044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 10045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 10046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 10047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 10048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 10049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 10050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 10051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 10052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 10053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 10054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 10055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 10056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 10057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 10058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 10059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 10060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 10061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 10062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 10063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 10064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 10065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 10066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 10067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 10068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 10069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 10070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 10071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 10072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 10073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 10074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 10075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 10076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 10077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 10078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 10079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 10080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 10081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 10082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 10083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 10084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 10085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 10086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 10087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 10088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 10089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 10090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 10091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 10092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 10093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 10094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 10095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 10096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 10097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 10098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 10099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 10100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 10101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 10102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 10103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 10104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 10105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 10106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 10107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 10108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 10109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 10110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 10111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 10112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 10113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 10114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 10115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 10116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 10117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 10118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 10119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 10120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 10121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 10122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 10123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 10124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 10125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 10126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 10127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 10128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 10129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 10130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 10131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 10132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 10133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 10134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 10135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 10136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 10137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 10138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 10139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 10140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 10141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 10142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 10143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 10144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 10145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 10146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 10147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 10148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 10149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 10150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 10151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 10152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 10153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 10154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 10155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 10156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 10157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 10158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 10159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 10160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 10161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 10162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 10163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 10164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 10165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 10166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 10167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 10168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 10169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 10170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 10171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 10172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 10173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 10174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 10175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 10176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 10177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 10178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 10179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 10180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 10181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 10182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 10183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 10184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 10185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 10186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 10187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 10188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 10189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 10190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 10191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 10192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 10193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 10194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 10195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 10196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 10197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 10198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 10199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 10200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 10201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 10202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 10203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 10204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 10205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 10206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 10207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 10208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 10209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 10210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 10211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 10212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 10213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 10214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 10215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 10216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 10217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 10218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 10219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 10220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 10221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 10222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 10223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 10224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 10225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 10226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 10227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 10228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 10229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 10230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 10231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 10232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 10233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 10234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 10235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 10236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 10237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 10238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 10239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 10240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 10241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 10242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 10243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 10244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 10245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 10246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 10247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 10248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 10249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 10250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 10251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 10252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 10253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 10254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 10255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 10256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 10257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 10258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 10259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 10260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 10261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 10262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 10263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 10264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 10265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 10266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 10267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 10268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 10269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 10270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 10271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 10272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 10273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 10274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 10275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 10276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 10277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 10278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 10279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 10280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 10281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 10282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 10283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 10284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 10285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 10286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 10287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 10288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 10289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 10290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 10291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 10292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 10293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 10294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 10295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 10296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 10297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 10298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 10299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 10300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 10301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 10302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 10303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 10304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 10305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 10306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 10307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 10308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 10309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 10310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 10311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 10312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 10313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 10314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 10315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 10316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 10317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 10318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 10319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 10320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 10321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 10322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 10323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 10324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 10325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 10326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 10327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 10328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 10329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 10330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 10331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 10332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 10333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 10334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 10335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 10336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 10337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 10338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 10339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 10340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 10341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 10342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 10343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 10344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 10345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 10346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 10347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 10348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 10349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 10350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 10351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 10352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 10353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 10354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 10355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 10356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 10357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 10358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 10359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 10360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 10361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 10362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 10363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 10364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 10365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 10366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 10367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 10368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 10369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 10370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 10371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 10372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 10373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 10374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 10375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 10376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 10377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 10378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 10379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 10380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 10381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 10382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 10383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 10384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 10385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 10386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 10387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 10388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 10389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 10390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 10391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 10392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 10393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 10394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 10395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 10396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 10397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 10398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 10399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 10400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 10401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 10402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 10403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 10404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 10405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 10406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 10407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 10408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 10409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 10410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 10411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 10412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 10413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 10414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 10415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 10416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 10417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 10418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 10419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 10420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 10421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 10422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 10423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 10424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 10425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 10426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 10427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 10428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 10429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 10430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 10431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 10432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 10433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 10434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 10435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 10436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 10437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 10438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 10439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 10440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 10441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 10442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 10443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 10444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 10445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 10446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 10447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 10448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 10449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 10450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 10451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 10452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 10453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 10454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 10455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 10456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 10457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 10458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 10459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 10460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 10461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 10462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 10463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 10464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 10465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 10466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 10467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 10468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 10469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 10470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 10471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 10472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 10473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 10474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 10475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 10476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 10477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 10478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 10479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 10480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 10481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 10482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 10483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 10484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 10485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 10486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 10487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 10488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 10489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 10490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 10491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 10492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 10493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 10494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 10495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 10496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 10497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 10498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 10499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 10500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 10501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 10502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 10503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 10504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 10505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 10506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 10507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 10508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 10509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 10510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 10511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 10512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 10513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 10514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 10515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 10516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 10517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 10518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 10519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 10520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 10521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 10522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 10523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 10524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 10525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 10526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 10527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 10528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 10529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 10530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 10531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 10532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 10533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 10534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 10535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 10536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 10537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 10538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 10539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 10540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 10541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 10542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 10543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 10544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 10545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 10546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 10547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 10548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 10549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 10550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 10551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 10552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 10553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 10554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 10555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 10556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 10557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 10558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 10559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 10560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 10561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 10562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 10563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 10564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 10565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 10566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 10567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 10568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 10569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 10570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 10571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 10572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 10573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 10574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 10575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 10576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 10577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 10578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 10579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 10580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 10581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 10582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 10583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 10584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 10585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 10586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 10587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 10588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 10589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 10590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 10591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 10592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 10593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 10594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 10595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 10596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 10597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 10598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 10599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 10600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 10601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 10602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 10603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 10604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 10605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 10606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 10607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 10608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 10609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 10610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 10611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 10612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 10613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 10614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 10615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 10616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 10617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 10618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 10619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 10620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 10621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 10622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 10623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 10624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 10625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 10626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 10627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 10628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 10629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 10630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 10631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 10632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 10633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 10634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 10635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 10636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 10637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 10638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 10639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 10640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 10641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 10642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 10643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 10644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 10645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 10646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 10647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 10648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 10649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 10650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 10651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 10652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 10653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 10654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 10655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 10656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 10657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 10658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 10659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 10660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 10661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 10662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 10663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 10664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 10665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 10666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 10667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 10668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 10669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 10670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 10671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 10672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 10673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 10674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 10675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 10676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 10677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 10678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 10679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 10680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 10681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 10682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 10683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 10684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 10685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 10686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 10687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 10688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 10689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 10690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 10691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 10692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 10693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 10694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 10695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 10696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 10697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 10698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 10699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 10700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 10701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 10702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 10703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 10704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 10705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 10706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 10707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 10708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 10709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 10710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 10711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 10712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 10713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 10714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 10715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 10716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 10717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 10718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 10719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 10720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 10721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 10722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 10723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 10724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 10725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 10726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 10727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 10728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 10729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 10730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 10731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 10732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 10733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 10734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 10735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 10736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 10737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 10738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 10739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 10740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 10741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 10742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 10743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 10744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 10745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 10746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 10747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 10748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 10749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 10750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 10751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 10752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 10753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 10754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 10755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 10756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 10757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 10758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 10759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 10760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 10761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 10762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 10763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 10764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 10765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 10766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 10767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 10768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 10769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 10770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 10771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 10772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 10773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 10774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 10775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 10776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 10777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 10778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 10779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 10780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 10781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 10782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 10783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 10784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 10785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 10786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 10787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 10788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 10789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 10790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 10791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 10792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 10793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 10794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 10795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 10796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 10797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 10798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 10799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 10800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 10801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 10802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 10803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 10804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 10805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 10806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 10807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 10808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 10809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 10810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 10811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 10812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 10813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 10814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 10815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 10816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 10817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 10818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 10819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 10820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 10821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 10822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 10823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 10824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 10825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 10826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 10827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 10828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 10829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 10830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 10831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 10832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 10833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 10834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 10835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 10836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 10837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 10838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 10839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 10840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 10841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 10842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 10843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 10844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 10845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 10846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 10847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 10848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 10849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 10850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 10851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 10852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 10853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 10854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 10855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 10856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 10857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 10858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 10859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 10860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 10861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 10862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 10863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 10864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 10865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 10866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 10867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 10868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 10869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 10870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 10871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 10872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 10873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 10874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 10875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 10876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 10877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 10878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 10879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 10880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 10881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 10882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 10883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 10884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 10885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 10886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 10887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 10888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 10889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 10890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 10891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 10892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 10893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 10894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 10895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 10896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 10897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 10898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 10899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 10900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 10901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 10902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 10903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 10904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 10905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 10906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 10907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 10908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 10909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 10910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 10911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 10912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 10913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 10914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 10915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 10916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 10917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 10918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 10919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 10920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 10921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 10922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 10923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 10924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 10925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 10926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 10927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 10928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 10929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 10930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 10931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 10932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 10933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 10934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 10935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 10936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 10937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 10938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 10939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 10940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 10941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 10942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 10943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 10944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 10945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 10946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 10947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 10948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 10949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 10950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 10951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 10952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 10953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 10954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 10955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 10956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 10957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 10958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 10959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 10960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 10961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 10962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 10963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 10964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 10965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 10966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 10967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 10968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 10969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 10970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 10971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 10972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 10973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 10974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 10975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 10976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 10977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 10978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 10979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 10980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 10981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 10982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 10983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 10984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 10985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 10986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 10987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 10988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 10989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 10990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 10991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 10992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 10993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 10994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 10995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 10996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 10997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 10998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 10999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 11000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 11001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 11002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 11003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 11004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 11005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 11006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 11007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 11008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 11009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 11010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 11011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 11012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 11013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 11014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 11015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 11016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 11017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 11018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 11019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 11020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 11021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 11022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 11023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 11024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 11025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 11026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 11027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 11028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 11029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 11030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 11031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 11032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 11033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 11034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 11035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 11036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 11037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 11038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 11039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 11040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 11041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 11042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 11043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 11044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 11045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 11046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 11047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 11048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 11049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 11050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 11051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 11052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 11053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 11054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 11055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 11056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 11057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 11058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 11059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 11060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 11061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 11062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 11063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 11064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 11065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 11066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 11067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 11068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 11069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 11070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 11071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 11072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 11073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 11074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 11075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 11076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 11077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 11078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 11079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 11080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 11081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 11082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 11083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 11084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 11085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 11086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 11087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 11088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 11089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 11090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 11091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 11092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 11093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 11094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 11095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 11096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 11097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 11098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 11099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 11100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 11101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 11102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 11103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 11104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 11105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 11106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 11107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 11108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 11109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 11110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 11111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 11112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 11113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 11114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 11115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 11116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 11117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 11118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 11119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 11120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 11121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 11122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 11123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 11124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 11125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 11126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 11127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 11128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 11129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 11130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 11131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 11132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 11133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 11134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 11135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 11136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 11137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 11138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 11139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 11140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 11141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 11142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 11143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 11144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 11145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 11146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 11147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 11148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 11149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 11150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 11151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 11152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 11153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 11154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 11155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 11156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 11157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 11158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 11159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 11160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 11161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 11162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 11163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 11164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 11165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 11166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 11167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 11168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 11169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 11170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 11171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 11172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 11173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 11174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 11175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 11176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 11177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 11178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 11179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 11180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 11181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 11182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 11183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 11184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 11185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 11186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 11187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 11188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 11189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 11190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 11191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 11192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 11193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 11194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 11195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 11196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 11197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 11198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 11199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 11200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 11201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 11202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 11203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 11204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 11205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 11206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 11207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 11208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 11209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 11210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 11211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 11212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 11213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 11214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 11215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 11216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 11217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 11218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 11219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 11220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 11221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 11222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 11223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 11224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 11225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 11226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 11227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 11228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 11229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 11230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 11231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 11232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 11233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 11234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 11235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 11236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 11237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 11238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 11239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 11240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 11241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 11242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 11243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 11244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 11245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 11246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 11247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 11248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 11249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 11250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 11251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 11252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 11253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 11254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 11255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 11256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 11257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 11258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 11259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 11260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 11261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 11262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 11263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 11264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 11265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 11266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 11267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 11268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 11269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 11270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 11271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 11272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 11273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 11274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 11275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 11276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 11277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 11278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 11279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 11280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 11281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 11282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 11283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 11284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 11285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 11286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 11287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 11288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 11289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 11290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 11291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 11292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 11293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 11294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 11295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 11296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 11297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 11298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 11299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 11300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 11301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 11302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 11303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 11304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 11305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 11306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 11307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 11308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 11309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 11310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 11311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 11312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 11313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 11314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 11315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 11316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 11317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 11318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 11319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 11320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 11321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 11322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 11323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 11324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 11325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 11326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 11327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 11328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 11329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 11330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 11331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 11332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 11333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 11334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 11335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 11336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 11337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 11338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 11339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 11340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 11341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 11342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 11343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 11344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 11345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 11346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 11347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 11348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 11349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 11350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 11351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 11352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 11353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 11354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 11355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 11356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 11357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 11358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 11359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 11360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 11361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 11362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 11363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 11364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 11365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 11366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 11367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 11368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 11369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 11370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 11371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 11372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 11373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 11374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 11375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 11376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 11377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 11378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 11379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 11380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 11381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 11382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 11383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 11384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 11385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 11386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 11387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 11388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 11389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 11390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 11391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 11392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 11393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 11394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 11395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 11396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 11397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 11398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 11399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 11400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 11401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 11402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 11403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 11404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 11405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 11406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 11407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 11408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 11409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 11410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 11411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 11412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 11413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 11414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 11415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 11416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 11417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 11418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 11419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 11420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 11421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 11422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 11423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 11424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 11425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 11426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 11427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 11428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 11429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 11430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 11431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 11432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 11433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 11434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 11435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 11436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 11437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 11438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 11439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 11440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 11441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 11442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 11443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 11444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 11445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 11446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 11447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 11448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 11449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 11450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 11451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 11452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 11453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 11454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 11455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 11456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 11457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 11458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 11459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 11460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 11461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 11462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 11463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 11464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 11465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 11466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 11467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 11468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 11469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 11470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 11471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 11472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 11473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 11474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 11475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 11476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 11477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 11478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 11479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 11480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 11481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 11482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 11483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 11484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 11485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 11486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 11487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 11488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 11489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 11490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 11491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 11492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 11493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 11494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 11495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 11496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 11497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 11498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 11499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 11500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 11501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 11502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 11503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 11504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 11505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 11506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 11507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 11508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 11509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 11510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 11511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 11512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 11513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 11514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 11515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 11516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 11517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 11518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 11519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 11520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 11521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 11522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 11523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 11524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 11525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 11526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 11527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 11528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 11529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 11530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 11531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 11532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 11533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 11534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 11535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 11536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 11537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 11538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 11539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 11540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 11541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 11542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 11543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 11544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 11545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 11546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 11547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 11548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 11549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 11550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 11551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 11552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 11553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 11554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 11555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 11556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 11557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 11558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 11559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 11560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 11561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 11562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 11563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 11564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 11565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 11566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 11567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 11568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 11569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 11570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 11571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 11572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 11573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 11574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 11575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 11576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 11577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 11578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 11579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 11580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 11581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 11582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 11583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 11584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 11585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 11586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 11587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 11588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 11589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 11590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 11591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 11592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 11593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 11594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 11595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 11596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 11597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 11598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 11599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 11600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 11601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 11602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 11603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 11604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 11605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 11606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 11607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 11608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 11609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 11610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 11611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 11612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 11613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 11614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 11615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 11616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 11617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 11618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 11619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 11620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 11621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 11622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 11623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 11624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 11625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 11626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 11627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 11628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 11629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 11630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 11631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 11632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 11633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 11634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 11635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 11636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 11637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 11638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 11639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 11640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 11641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 11642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 11643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 11644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 11645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 11646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 11647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 11648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 11649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 11650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 11651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 11652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 11653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 11654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 11655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 11656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 11657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 11658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 11659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 11660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 11661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 11662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 11663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 11664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 11665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 11666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 11667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 11668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 11669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 11670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 11671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 11672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 11673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 11674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 11675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 11676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 11677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 11678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 11679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 11680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 11681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 11682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 11683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 11684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 11685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 11686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 11687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 11688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 11689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 11690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 11691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 11692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 11693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 11694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 11695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 11696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 11697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 11698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 11699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 11700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 11701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 11702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 11703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 11704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 11705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 11706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 11707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 11708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 11709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 11710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 11711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 11712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 11713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 11714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 11715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 11716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 11717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 11718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 11719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 11720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 11721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 11722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 11723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 11724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 11725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 11726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 11727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 11728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 11729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 11730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 11731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 11732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 11733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 11734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 11735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 11736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 11737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 11738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 11739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 11740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 11741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 11742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 11743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 11744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 11745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 11746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 11747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 11748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 11749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 11750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 11751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 11752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 11753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 11754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 11755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 11756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 11757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 11758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 11759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 11760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 11761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 11762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 11763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 11764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 11765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 11766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 11767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 11768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 11769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 11770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 11771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 11772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 11773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 11774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 11775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 11776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 11777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 11778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 11779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 11780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 11781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 11782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 11783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 11784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 11785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 11786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 11787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 11788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 11789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 11790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 11791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 11792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 11793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 11794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 11795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 11796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 11797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 11798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 11799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 11800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 11801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 11802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 11803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 11804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 11805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 11806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 11807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 11808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 11809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 11810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 11811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 11812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 11813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 11814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 11815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 11816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 11817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 11818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 11819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 11820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 11821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 11822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 11823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 11824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 11825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 11826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 11827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 11828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 11829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 11830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 11831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 11832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 11833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 11834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 11835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 11836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 11837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 11838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 11839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 11840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 11841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 11842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 11843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 11844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 11845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 11846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 11847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 11848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 11849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 11850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 11851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 11852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 11853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 11854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 11855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 11856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 11857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 11858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 11859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 11860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 11861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 11862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 11863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 11864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 11865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 11866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 11867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 11868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 11869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 11870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 11871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 11872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 11873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 11874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 11875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 11876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 11877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 11878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 11879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 11880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 11881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 11882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 11883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 11884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 11885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 11886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 11887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 11888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 11889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 11890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 11891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 11892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 11893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 11894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 11895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 11896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 11897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 11898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 11899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 11900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 11901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 11902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 11903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 11904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 11905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 11906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 11907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 11908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 11909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 11910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 11911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 11912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 11913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 11914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 11915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 11916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 11917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 11918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 11919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 11920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 11921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 11922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 11923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 11924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 11925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 11926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 11927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 11928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 11929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 11930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 11931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 11932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 11933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 11934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 11935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 11936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 11937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 11938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 11939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 11940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 11941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 11942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 11943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 11944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 11945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 11946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 11947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 11948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 11949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 11950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 11951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 11952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 11953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 11954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 11955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 11956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 11957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 11958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 11959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 11960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 11961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 11962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 11963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 11964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 11965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 11966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 11967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 11968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 11969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 11970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 11971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 11972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 11973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 11974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 11975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 11976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 11977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 11978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 11979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 11980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 11981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 11982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 11983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 11984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 11985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 11986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 11987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 11988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 11989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 11990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 11991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 11992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 11993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 11994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 11995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 11996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 11997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 11998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 11999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 12000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 12001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 12002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 12003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 12004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 12005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 12006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 12007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 12008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 12009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 12010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 12011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 12012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 12013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 12014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 12015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 12016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 12017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 12018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 12019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 12020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 12021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 12022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 12023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 12024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 12025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 12026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 12027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 12028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 12029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 12030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 12031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 12032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 12033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 12034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 12035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 12036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 12037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 12038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 12039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 12040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 12041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 12042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 12043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 12044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 12045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 12046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 12047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 12048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 12049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 12050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 12051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 12052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 12053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 12054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 12055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 12056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 12057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 12058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 12059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 12060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 12061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 12062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 12063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 12064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 12065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 12066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 12067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 12068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 12069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 12070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 12071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 12072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 12073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 12074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 12075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 12076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 12077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 12078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 12079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 12080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 12081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 12082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 12083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 12084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 12085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 12086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 12087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 12088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 12089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 12090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 12091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 12092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 12093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 12094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 12095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 12096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 12097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 12098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 12099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 12100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 12101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 12102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 12103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 12104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 12105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 12106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 12107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 12108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 12109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 12110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 12111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 12112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 12113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 12114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 12115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 12116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 12117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 12118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 12119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 12120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 12121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 12122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 12123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 12124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 12125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 12126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 12127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 12128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 12129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 12130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 12131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 12132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 12133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 12134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 12135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 12136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 12137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 12138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 12139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 12140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 12141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 12142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 12143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 12144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 12145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 12146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 12147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 12148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 12149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 12150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 12151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 12152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 12153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 12154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 12155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 12156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 12157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 12158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 12159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 12160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 12161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 12162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 12163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 12164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 12165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 12166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 12167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 12168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 12169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 12170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 12171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 12172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 12173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 12174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 12175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 12176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 12177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 12178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 12179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 12180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 12181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 12182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 12183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 12184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 12185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 12186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 12187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 12188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 12189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 12190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 12191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 12192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 12193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 12194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 12195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 12196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 12197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 12198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 12199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 12200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 12201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 12202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 12203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 12204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 12205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 12206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 12207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 12208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 12209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 12210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 12211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 12212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 12213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 12214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 12215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 12216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 12217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 12218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 12219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 12220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 12221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 12222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 12223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 12224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 12225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 12226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 12227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 12228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 12229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 12230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 12231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 12232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 12233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 12234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 12235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 12236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 12237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 12238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 12239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 12240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 12241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 12242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 12243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 12244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 12245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 12246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 12247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 12248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 12249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 12250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 12251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 12252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 12253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 12254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 12255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 12256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 12257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 12258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 12259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 12260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 12261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 12262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 12263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 12264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 12265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 12266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 12267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 12268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 12269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 12270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 12271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 12272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 12273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 12274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 12275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 12276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 12277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 12278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 12279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 12280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 12281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 12282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 12283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 12284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 12285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 12286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 12287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 12288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 12289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 12290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 12291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 12292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 12293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 12294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 12295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 12296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 12297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 12298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 12299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 12300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 12301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 12302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 12303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 12304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 12305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 12306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 12307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 12308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 12309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 12310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 12311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 12312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 12313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 12314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 12315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 12316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 12317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 12318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 12319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 12320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 12321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 12322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 12323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 12324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 12325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 12326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 12327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 12328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 12329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 12330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 12331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 12332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 12333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 12334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 12335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 12336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 12337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 12338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 12339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 12340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 12341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 12342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 12343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 12344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 12345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 12346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 12347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 12348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 12349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 12350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 12351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 12352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 12353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 12354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 12355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 12356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 12357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 12358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 12359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 12360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 12361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 12362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 12363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 12364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 12365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 12366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 12367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 12368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 12369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 12370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 12371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 12372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 12373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 12374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 12375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 12376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 12377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 12378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 12379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 12380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 12381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 12382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 12383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 12384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 12385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 12386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 12387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 12388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 12389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 12390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 12391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 12392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 12393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 12394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 12395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 12396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 12397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 12398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 12399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 12400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 12401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 12402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 12403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 12404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 12405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 12406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 12407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 12408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 12409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 12410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 12411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 12412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 12413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 12414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 12415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 12416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 12417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 12418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 12419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 12420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 12421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 12422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 12423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 12424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 12425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 12426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 12427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 12428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 12429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 12430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 12431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 12432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 12433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 12434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 12435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 12436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 12437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 12438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 12439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 12440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 12441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 12442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 12443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 12444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 12445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 12446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 12447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 12448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 12449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 12450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 12451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 12452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 12453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 12454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 12455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 12456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 12457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 12458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 12459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 12460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 12461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 12462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 12463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 12464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 12465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 12466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 12467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 12468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 12469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 12470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 12471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 12472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 12473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 12474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 12475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 12476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 12477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 12478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 12479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 12480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 12481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 12482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 12483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 12484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 12485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 12486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 12487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 12488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 12489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 12490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 12491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 12492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 12493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 12494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 12495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 12496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 12497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 12498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 12499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 12500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 12501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 12502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 12503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 12504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 12505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 12506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 12507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 12508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 12509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 12510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 12511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 12512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 12513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 12514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 12515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 12516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 12517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 12518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 12519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 12520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 12521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 12522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 12523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 12524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 12525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 12526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 12527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 12528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 12529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 12530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 12531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 12532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 12533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 12534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 12535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 12536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 12537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 12538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 12539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 12540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 12541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 12542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 12543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 12544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 12545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 12546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 12547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 12548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 12549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 12550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 12551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 12552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 12553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 12554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 12555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 12556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 12557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 12558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 12559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 12560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 12561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 12562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 12563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 12564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 12565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 12566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 12567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 12568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 12569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 12570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 12571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 12572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 12573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 12574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 12575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 12576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 12577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 12578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 12579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 12580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 12581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 12582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 12583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 12584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 12585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 12586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 12587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 12588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 12589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 12590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 12591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 12592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 12593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 12594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 12595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 12596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 12597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 12598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 12599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 12600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 12601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 12602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 12603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 12604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 12605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 12606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 12607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 12608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 12609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 12610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 12611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 12612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 12613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 12614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 12615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 12616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 12617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 12618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 12619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 12620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 12621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 12622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 12623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 12624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 12625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 12626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 12627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 12628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 12629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 12630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 12631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 12632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 12633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 12634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 12635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 12636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 12637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 12638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 12639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 12640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 12641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 12642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 12643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 12644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 12645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 12646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 12647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 12648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 12649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 12650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 12651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 12652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 12653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 12654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 12655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 12656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 12657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 12658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 12659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 12660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 12661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 12662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 12663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 12664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 12665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 12666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 12667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 12668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 12669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 12670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 12671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 12672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 12673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 12674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 12675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 12676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 12677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 12678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 12679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 12680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 12681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 12682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 12683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 12684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 12685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 12686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 12687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 12688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 12689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 12690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 12691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 12692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 12693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 12694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 12695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 12696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 12697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 12698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 12699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 12700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 12701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 12702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 12703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 12704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 12705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 12706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 12707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 12708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 12709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 12710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 12711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 12712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 12713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 12714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 12715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 12716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 12717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 12718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 12719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 12720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 12721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 12722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 12723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 12724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 12725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 12726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 12727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 12728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 12729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 12730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 12731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 12732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 12733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 12734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 12735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 12736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 12737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 12738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 12739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 12740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 12741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 12742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 12743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 12744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 12745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 12746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 12747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 12748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 12749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 12750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 12751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 12752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 12753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 12754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 12755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 12756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 12757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 12758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 12759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 12760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 12761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 12762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 12763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 12764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 12765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 12766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 12767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 12768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 12769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 12770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 12771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 12772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 12773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 12774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 12775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 12776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 12777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 12778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 12779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 12780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 12781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 12782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 12783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 12784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 12785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 12786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 12787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 12788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 12789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 12790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 12791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 12792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 12793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 12794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 12795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 12796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 12797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 12798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 12799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 12800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 12801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 12802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 12803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 12804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 12805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 12806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 12807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 12808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 12809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 12810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 12811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 12812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 12813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 12814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 12815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 12816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 12817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 12818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 12819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 12820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 12821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 12822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 12823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 12824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 12825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 12826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 12827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 12828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 12829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 12830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 12831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 12832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 12833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 12834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 12835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 12836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 12837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 12838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 12839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 12840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 12841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 12842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 12843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 12844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 12845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 12846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 12847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 12848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 12849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 12850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 12851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 12852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 12853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 12854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 12855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 12856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 12857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 12858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 12859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 12860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 12861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 12862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 12863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 12864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 12865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 12866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 12867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 12868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 12869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 12870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 12871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 12872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 12873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 12874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 12875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 12876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 12877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 12878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 12879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 12880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 12881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 12882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 12883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 12884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 12885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 12886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 12887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 12888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 12889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 12890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 12891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 12892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 12893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 12894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 12895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 12896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 12897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 12898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 12899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 12900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 12901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 12902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 12903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 12904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 12905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 12906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 12907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 12908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 12909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 12910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 12911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 12912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 12913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 12914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 12915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 12916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 12917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 12918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 12919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 12920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 12921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 12922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 12923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 12924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 12925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 12926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 12927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 12928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 12929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 12930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 12931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 12932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 12933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 12934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 12935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 12936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 12937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 12938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 12939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 12940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 12941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 12942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 12943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 12944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 12945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 12946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 12947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 12948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 12949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 12950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 12951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 12952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 12953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 12954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 12955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 12956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 12957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 12958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 12959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 12960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 12961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 12962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 12963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 12964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 12965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 12966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 12967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 12968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 12969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 12970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 12971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 12972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 12973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 12974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 12975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 12976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 12977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 12978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 12979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 12980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 12981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 12982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 12983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 12984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 12985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 12986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 12987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 12988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 12989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 12990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 12991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 12992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 12993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 12994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 12995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 12996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 12997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 12998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 12999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 13000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 13001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 13002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 13003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 13004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 13005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 13006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 13007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 13008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 13009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 13010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 13011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 13012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 13013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 13014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 13015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 13016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 13017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 13018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 13019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 13020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 13021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 13022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 13023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 13024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 13025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 13026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 13027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 13028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 13029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 13030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 13031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 13032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 13033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 13034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 13035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 13036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 13037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 13038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 13039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 13040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 13041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 13042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 13043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 13044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 13045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 13046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 13047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 13048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 13049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 13050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 13051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 13052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 13053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 13054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 13055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 13056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 13057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 13058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 13059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 13060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 13061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 13062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 13063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 13064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 13065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 13066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 13067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 13068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 13069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 13070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 13071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 13072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 13073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 13074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 13075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 13076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 13077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 13078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 13079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 13080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 13081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 13082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 13083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 13084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 13085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 13086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 13087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 13088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 13089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 13090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 13091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 13092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 13093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 13094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 13095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 13096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 13097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 13098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 13099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 13100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 13101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 13102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 13103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 13104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 13105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 13106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 13107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 13108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 13109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 13110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 13111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 13112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 13113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 13114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 13115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 13116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 13117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 13118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 13119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 13120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 13121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 13122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 13123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 13124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 13125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 13126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 13127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 13128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 13129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 13130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 13131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 13132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 13133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 13134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 13135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 13136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 13137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 13138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 13139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 13140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 13141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 13142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 13143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 13144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 13145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 13146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 13147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 13148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 13149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 13150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 13151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 13152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 13153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 13154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 13155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 13156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 13157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 13158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 13159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 13160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 13161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 13162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 13163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 13164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 13165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 13166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 13167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 13168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 13169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 13170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 13171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 13172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 13173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 13174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 13175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 13176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 13177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 13178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 13179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 13180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 13181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 13182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 13183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 13184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 13185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 13186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 13187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 13188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 13189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 13190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 13191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 13192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 13193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 13194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 13195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 13196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 13197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 13198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 13199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 13200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 13201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 13202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 13203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 13204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 13205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 13206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 13207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 13208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 13209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 13210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 13211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 13212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 13213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 13214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 13215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 13216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 13217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 13218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 13219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 13220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 13221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 13222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 13223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 13224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 13225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 13226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 13227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 13228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 13229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 13230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 13231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 13232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 13233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 13234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 13235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 13236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 13237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 13238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 13239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 13240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 13241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 13242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 13243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 13244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 13245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 13246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 13247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 13248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 13249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 13250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 13251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 13252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 13253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 13254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 13255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 13256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 13257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 13258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 13259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 13260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 13261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 13262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 13263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 13264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 13265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 13266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 13267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 13268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 13269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 13270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 13271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 13272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 13273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 13274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 13275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 13276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 13277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 13278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 13279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 13280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 13281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 13282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 13283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 13284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 13285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 13286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 13287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 13288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 13289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 13290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 13291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 13292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 13293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 13294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 13295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 13296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 13297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 13298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 13299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 13300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 13301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 13302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 13303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 13304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 13305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 13306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 13307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 13308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 13309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 13310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 13311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 13312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 13313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 13314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 13315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 13316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 13317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 13318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 13319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 13320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 13321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 13322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 13323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 13324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 13325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 13326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 13327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 13328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 13329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 13330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 13331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 13332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 13333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 13334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 13335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 13336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 13337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 13338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 13339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 13340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 13341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 13342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 13343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 13344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 13345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 13346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 13347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 13348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 13349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 13350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 13351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 13352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 13353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 13354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 13355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 13356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 13357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 13358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 13359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 13360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 13361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 13362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 13363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 13364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 13365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 13366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 13367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 13368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 13369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 13370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 13371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 13372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 13373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 13374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 13375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 13376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 13377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 13378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 13379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 13380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 13381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 13382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 13383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 13384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 13385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 13386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 13387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 13388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 13389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 13390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 13391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 13392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 13393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 13394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 13395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 13396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 13397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 13398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 13399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 13400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 13401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 13402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 13403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 13404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 13405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 13406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 13407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 13408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 13409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 13410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 13411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 13412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 13413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 13414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 13415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 13416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 13417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 13418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 13419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 13420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 13421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 13422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 13423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 13424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 13425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 13426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 13427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 13428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 13429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 13430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 13431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 13432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 13433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 13434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 13435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 13436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 13437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 13438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 13439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 13440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 13441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 13442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 13443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 13444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 13445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 13446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 13447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 13448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 13449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 13450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 13451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 13452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 13453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 13454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 13455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 13456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 13457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 13458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 13459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 13460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 13461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 13462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 13463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 13464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 13465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 13466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 13467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 13468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 13469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 13470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 13471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 13472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 13473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 13474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 13475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 13476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 13477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 13478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 13479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 13480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 13481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 13482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 13483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 13484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 13485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 13486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 13487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 13488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 13489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 13490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 13491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 13492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 13493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 13494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 13495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 13496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 13497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 13498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 13499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 13500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 13501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 13502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 13503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 13504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 13505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 13506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 13507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 13508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 13509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 13510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 13511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 13512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 13513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 13514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 13515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 13516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 13517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 13518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 13519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 13520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 13521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 13522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 13523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 13524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 13525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 13526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 13527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 13528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 13529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 13530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 13531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 13532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 13533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 13534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 13535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 13536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 13537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 13538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 13539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 13540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 13541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 13542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 13543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 13544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 13545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 13546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 13547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 13548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 13549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 13550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 13551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 13552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 13553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 13554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 13555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 13556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 13557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 13558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 13559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 13560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 13561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 13562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 13563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 13564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 13565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 13566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 13567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 13568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 13569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 13570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 13571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 13572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 13573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 13574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 13575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 13576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 13577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 13578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 13579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 13580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 13581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 13582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 13583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 13584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 13585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 13586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 13587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 13588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 13589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 13590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 13591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 13592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 13593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 13594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 13595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 13596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 13597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 13598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 13599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 13600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 13601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 13602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 13603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 13604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 13605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 13606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 13607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 13608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 13609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 13610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 13611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 13612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 13613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 13614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 13615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 13616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 13617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 13618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 13619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 13620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 13621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 13622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 13623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 13624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 13625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 13626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 13627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 13628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 13629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 13630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 13631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 13632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 13633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 13634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 13635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 13636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 13637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 13638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 13639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 13640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 13641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 13642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 13643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 13644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 13645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 13646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 13647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 13648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 13649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 13650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 13651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 13652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 13653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 13654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 13655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 13656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 13657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 13658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 13659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 13660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 13661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 13662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 13663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 13664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 13665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 13666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 13667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 13668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 13669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 13670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 13671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 13672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 13673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 13674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 13675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 13676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 13677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 13678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 13679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 13680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 13681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 13682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 13683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 13684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 13685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 13686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 13687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 13688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 13689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 13690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 13691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 13692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 13693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 13694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 13695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 13696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 13697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 13698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 13699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 13700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 13701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 13702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 13703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 13704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 13705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 13706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 13707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 13708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 13709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 13710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 13711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 13712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 13713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 13714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 13715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 13716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 13717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 13718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 13719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 13720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 13721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 13722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 13723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 13724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 13725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 13726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 13727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 13728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 13729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 13730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 13731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 13732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 13733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 13734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 13735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 13736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 13737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 13738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 13739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 13740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 13741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 13742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 13743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 13744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 13745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 13746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 13747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 13748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 13749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 13750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 13751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 13752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 13753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 13754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 13755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 13756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 13757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 13758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 13759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 13760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 13761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 13762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 13763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 13764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 13765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 13766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 13767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 13768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 13769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 13770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 13771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 13772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 13773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 13774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 13775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 13776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 13777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 13778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 13779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 13780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 13781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 13782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 13783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 13784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 13785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 13786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 13787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 13788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 13789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 13790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 13791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 13792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 13793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 13794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 13795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 13796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 13797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 13798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 13799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 13800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 13801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 13802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 13803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 13804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 13805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 13806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 13807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 13808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 13809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 13810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 13811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 13812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 13813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 13814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 13815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 13816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 13817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 13818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 13819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 13820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 13821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 13822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 13823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 13824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 13825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 13826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 13827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 13828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 13829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 13830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 13831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 13832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 13833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 13834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 13835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 13836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 13837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 13838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 13839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 13840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 13841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 13842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 13843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 13844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 13845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 13846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 13847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 13848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 13849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 13850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 13851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 13852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 13853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 13854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 13855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 13856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 13857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 13858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 13859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 13860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 13861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 13862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 13863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 13864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 13865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 13866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 13867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 13868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 13869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 13870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 13871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 13872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 13873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 13874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 13875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 13876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 13877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 13878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 13879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 13880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 13881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 13882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 13883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 13884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 13885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 13886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 13887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 13888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 13889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 13890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 13891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 13892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 13893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 13894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 13895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 13896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 13897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 13898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 13899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 13900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 13901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 13902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 13903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 13904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 13905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 13906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 13907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 13908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 13909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 13910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 13911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 13912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 13913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 13914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 13915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 13916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 13917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 13918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 13919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 13920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 13921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 13922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 13923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 13924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 13925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 13926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 13927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 13928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 13929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 13930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 13931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 13932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 13933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 13934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 13935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 13936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 13937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 13938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 13939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 13940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 13941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 13942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 13943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 13944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 13945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 13946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 13947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 13948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 13949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 13950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 13951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 13952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 13953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 13954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 13955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 13956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 13957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 13958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 13959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 13960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 13961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 13962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 13963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 13964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 13965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 13966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 13967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 13968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 13969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 13970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 13971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 13972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 13973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 13974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 13975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 13976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 13977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 13978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 13979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 13980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 13981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 13982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 13983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 13984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 13985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 13986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 13987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 13988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 13989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 13990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 13991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 13992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 13993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 13994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 13995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 13996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 13997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 13998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 13999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 14000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 14001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 14002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 14003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 14004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 14005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 14006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 14007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 14008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 14009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 14010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 14011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 14012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 14013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 14014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 14015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 14016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 14017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 14018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 14019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 14020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 14021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 14022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 14023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 14024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 14025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 14026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 14027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 14028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 14029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 14030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 14031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 14032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 14033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 14034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 14035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 14036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 14037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 14038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 14039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 14040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 14041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 14042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 14043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 14044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 14045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 14046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 14047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 14048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 14049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 14050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 14051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 14052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 14053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 14054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 14055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 14056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 14057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 14058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 14059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 14060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 14061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 14062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 14063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 14064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 14065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 14066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 14067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 14068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 14069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 14070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 14071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 14072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 14073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 14074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 14075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 14076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 14077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 14078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 14079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 14080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 14081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 14082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 14083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 14084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 14085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 14086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 14087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 14088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 14089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 14090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 14091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 14092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 14093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 14094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 14095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 14096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 14097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 14098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 14099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 14100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 14101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 14102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 14103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 14104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 14105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 14106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 14107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 14108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 14109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 14110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 14111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 14112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 14113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 14114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 14115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 14116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 14117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 14118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 14119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 14120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 14121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 14122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 14123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 14124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 14125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 14126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 14127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 14128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 14129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 14130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 14131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 14132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 14133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 14134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 14135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 14136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 14137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 14138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 14139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 14140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 14141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 14142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 14143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 14144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 14145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 14146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 14147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 14148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 14149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 14150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 14151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 14152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 14153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 14154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 14155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 14156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 14157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 14158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 14159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 14160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 14161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 14162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 14163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 14164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 14165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 14166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 14167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 14168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 14169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 14170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 14171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 14172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 14173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 14174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 14175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 14176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 14177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 14178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 14179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 14180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 14181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 14182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 14183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 14184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 14185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 14186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 14187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 14188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 14189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 14190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 14191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 14192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 14193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 14194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 14195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 14196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 14197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 14198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 14199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 14200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 14201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 14202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 14203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 14204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 14205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 14206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 14207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 14208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 14209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 14210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 14211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 14212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 14213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 14214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 14215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 14216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 14217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 14218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 14219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 14220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 14221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 14222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 14223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 14224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 14225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 14226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 14227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 14228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 14229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 14230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 14231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 14232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 14233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 14234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 14235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 14236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 14237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 14238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 14239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 14240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 14241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 14242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 14243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 14244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 14245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 14246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 14247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 14248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 14249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 14250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 14251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 14252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 14253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 14254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 14255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 14256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 14257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 14258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 14259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 14260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 14261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 14262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 14263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 14264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 14265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 14266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 14267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 14268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 14269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 14270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 14271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 14272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 14273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 14274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 14275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 14276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 14277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 14278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 14279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 14280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 14281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 14282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 14283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 14284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 14285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 14286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 14287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 14288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 14289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 14290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 14291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 14292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 14293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 14294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 14295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 14296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 14297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 14298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 14299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 14300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 14301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 14302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 14303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 14304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 14305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 14306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 14307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 14308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 14309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 14310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 14311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 14312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 14313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 14314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 14315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 14316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 14317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 14318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 14319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 14320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 14321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 14322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 14323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 14324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 14325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 14326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 14327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 14328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 14329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 14330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 14331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 14332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 14333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 14334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 14335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 14336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 14337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 14338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 14339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 14340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 14341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 14342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 14343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 14344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 14345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 14346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 14347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 14348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 14349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 14350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 14351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 14352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 14353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 14354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 14355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 14356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 14357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 14358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 14359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 14360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 14361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 14362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 14363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 14364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 14365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 14366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 14367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 14368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 14369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 14370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 14371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 14372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 14373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 14374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 14375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 14376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 14377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 14378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 14379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 14380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 14381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 14382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 14383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 14384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 14385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 14386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 14387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 14388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 14389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 14390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 14391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 14392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 14393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 14394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 14395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 14396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 14397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 14398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 14399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 14400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 14401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 14402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 14403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 14404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 14405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 14406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 14407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 14408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 14409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 14410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 14411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 14412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 14413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 14414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 14415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 14416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 14417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 14418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 14419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 14420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 14421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 14422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 14423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 14424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 14425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 14426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 14427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 14428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 14429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 14430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 14431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 14432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 14433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 14434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 14435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 14436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 14437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 14438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 14439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 14440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 14441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 14442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 14443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 14444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 14445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 14446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 14447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 14448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 14449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 14450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 14451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 14452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 14453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 14454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 14455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 14456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 14457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 14458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 14459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 14460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 14461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 14462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 14463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 14464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 14465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 14466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 14467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 14468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 14469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 14470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 14471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 14472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 14473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 14474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 14475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 14476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 14477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 14478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 14479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 14480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 14481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 14482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 14483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 14484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 14485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 14486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 14487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 14488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 14489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 14490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 14491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 14492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 14493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 14494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 14495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 14496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 14497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 14498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 14499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 14500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 14501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 14502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 14503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 14504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 14505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 14506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 14507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 14508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 14509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 14510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 14511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 14512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 14513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 14514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 14515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 14516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 14517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 14518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 14519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 14520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 14521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 14522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 14523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 14524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 14525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 14526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 14527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 14528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 14529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 14530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 14531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 14532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 14533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 14534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 14535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 14536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 14537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 14538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 14539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 14540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 14541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 14542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 14543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 14544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 14545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 14546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 14547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 14548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 14549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 14550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 14551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 14552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 14553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 14554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 14555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 14556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 14557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 14558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 14559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 14560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 14561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 14562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 14563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 14564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 14565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 14566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 14567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 14568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 14569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 14570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 14571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 14572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 14573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 14574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 14575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 14576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 14577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 14578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 14579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 14580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 14581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 14582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 14583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 14584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 14585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 14586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 14587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 14588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 14589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 14590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 14591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 14592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 14593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 14594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 14595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 14596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 14597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 14598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 14599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 14600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 14601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 14602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 14603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 14604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 14605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 14606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 14607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 14608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 14609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 14610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 14611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 14612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 14613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 14614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 14615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 14616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 14617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 14618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 14619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 14620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 14621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 14622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 14623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 14624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 14625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 14626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 14627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 14628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 14629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 14630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 14631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 14632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 14633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 14634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 14635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 14636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 14637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 14638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 14639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 14640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 14641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 14642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 14643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 14644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 14645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 14646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 14647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 14648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 14649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 14650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 14651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 14652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 14653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 14654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 14655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 14656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 14657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 14658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 14659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 14660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 14661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 14662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 14663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 14664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 14665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 14666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 14667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 14668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 14669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 14670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 14671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 14672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 14673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 14674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 14675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 14676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 14677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 14678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 14679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 14680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 14681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 14682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 14683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 14684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 14685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 14686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 14687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 14688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 14689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 14690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 14691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 14692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 14693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 14694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 14695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 14696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 14697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 14698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 14699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 14700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 14701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 14702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 14703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 14704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 14705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 14706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 14707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 14708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 14709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 14710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 14711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 14712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 14713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 14714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 14715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 14716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 14717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 14718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 14719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 14720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 14721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 14722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 14723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 14724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 14725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 14726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 14727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 14728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 14729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 14730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 14731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 14732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 14733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 14734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 14735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 14736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 14737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 14738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 14739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 14740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 14741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 14742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 14743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 14744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 14745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 14746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 14747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 14748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 14749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 14750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 14751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 14752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 14753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 14754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 14755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 14756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 14757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 14758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 14759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 14760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 14761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 14762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 14763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 14764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 14765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 14766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 14767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 14768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 14769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 14770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 14771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 14772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 14773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 14774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 14775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 14776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 14777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 14778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 14779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 14780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 14781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 14782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 14783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 14784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 14785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 14786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 14787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 14788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 14789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 14790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 14791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 14792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 14793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 14794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 14795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 14796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 14797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 14798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 14799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 14800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 14801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 14802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 14803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 14804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 14805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 14806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 14807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 14808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 14809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 14810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 14811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 14812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 14813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 14814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 14815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 14816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 14817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 14818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 14819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 14820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 14821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 14822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 14823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 14824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 14825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 14826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 14827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 14828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 14829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 14830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 14831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 14832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 14833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 14834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 14835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 14836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 14837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 14838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 14839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 14840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 14841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 14842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 14843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 14844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 14845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 14846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 14847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 14848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 14849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 14850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 14851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 14852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 14853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 14854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 14855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 14856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 14857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 14858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 14859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 14860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 14861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 14862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 14863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 14864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 14865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 14866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 14867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 14868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 14869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 14870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 14871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 14872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 14873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 14874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 14875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 14876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 14877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 14878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 14879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 14880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 14881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 14882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 14883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 14884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 14885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 14886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 14887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 14888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 14889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 14890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 14891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 14892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 14893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 14894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 14895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 14896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 14897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 14898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 14899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 14900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 14901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 14902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 14903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 14904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 14905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 14906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 14907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 14908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 14909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 14910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 14911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 14912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 14913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 14914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 14915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 14916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 14917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 14918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 14919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 14920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 14921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 14922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 14923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 14924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 14925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 14926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 14927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 14928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 14929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 14930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 14931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 14932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 14933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 14934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 14935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 14936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 14937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 14938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 14939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 14940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 14941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 14942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 14943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 14944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 14945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 14946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 14947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 14948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 14949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 14950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 14951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 14952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 14953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 14954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 14955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 14956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 14957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 14958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 14959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 14960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 14961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 14962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 14963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 14964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 14965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 14966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 14967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 14968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 14969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 14970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 14971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 14972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 14973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 14974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 14975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 14976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 14977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 14978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 14979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 14980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 14981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 14982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 14983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 14984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 14985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 14986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 14987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 14988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 14989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 14990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 14991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 14992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 14993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 14994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 14995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 14996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 14997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 14998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 14999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 15000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 15001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 15002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 15003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 15004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 15005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 15006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 15007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 15008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 15009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 15010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 15011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 15012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 15013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 15014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 15015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 15016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 15017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 15018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 15019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 15020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 15021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 15022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 15023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 15024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 15025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 15026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 15027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 15028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 15029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 15030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 15031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 15032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 15033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 15034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 15035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 15036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 15037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 15038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 15039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 15040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 15041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 15042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 15043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 15044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 15045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 15046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 15047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 15048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 15049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 15050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 15051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 15052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 15053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 15054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 15055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 15056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 15057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 15058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 15059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 15060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 15061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 15062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 15063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 15064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 15065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 15066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 15067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 15068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 15069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 15070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 15071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 15072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 15073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 15074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 15075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 15076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 15077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 15078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 15079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 15080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 15081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 15082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 15083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 15084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 15085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 15086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 15087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 15088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 15089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 15090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 15091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 15092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 15093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 15094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 15095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 15096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 15097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 15098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 15099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 15100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 15101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 15102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 15103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 15104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 15105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 15106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 15107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 15108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 15109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 15110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 15111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 15112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 15113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 15114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 15115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 15116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 15117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 15118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 15119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 15120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 15121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 15122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 15123 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 15124 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 15125 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 15126 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 15127 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 15128 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 15129 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 15130 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 15131 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 15132 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 15133 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 15134 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 15135 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 15136 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 15137 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 15138 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 15139 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 15140 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 15141 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 15142 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 15143 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 15144 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 15145 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 15146 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 15147 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 15148 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 15149 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 15150 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 15151 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 15152 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 15153 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 15154 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 15155 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 15156 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 15157 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 15158 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 15159 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 15160 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 15161 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 15162 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 15163 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 15164 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 15165 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 15166 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 15167 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 15168 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 15169 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 15170 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 15171 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 15172 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 15173 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 15174 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 15175 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 15176 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 15177 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 15178 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 15179 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 15180 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 15181 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 15182 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 15183 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 15184 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 15185 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 15186 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 15187 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 15188 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 15189 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 15190 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 15191 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 15192 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 15193 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 15194 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 15195 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 15196 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 15197 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 15198 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 15199 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 15200 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 15201 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 15202 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 15203 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 15204 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 15205 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 15206 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 15207 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 15208 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 15209 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 15210 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 15211 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 15212 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 15213 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 15214 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 15215 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 15216 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 15217 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 15218 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 15219 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 15220 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 15221 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 15222 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 15223 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 15224 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 15225 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 15226 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 15227 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 15228 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 15229 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 15230 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 15231 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 15232 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 15233 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 15234 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 15235 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 15236 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 15237 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 15238 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 15239 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 15240 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 15241 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 15242 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 15243 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 15244 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 15245 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 15246 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 15247 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 15248 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 15249 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 15250 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 15251 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 15252 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 15253 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 15254 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 15255 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 15256 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 15257 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 15258 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 15259 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 15260 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 15261 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 15262 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 15263 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 15264 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 15265 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 15266 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 15267 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 15268 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 15269 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 15270 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 15271 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 15272 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 15273 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 15274 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 15275 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 15276 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 15277 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 15278 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 15279 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 15280 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 15281 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 15282 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 15283 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 15284 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 15285 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 15286 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 15287 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 15288 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 15289 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 15290 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 15291 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 15292 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 15293 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 15294 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 15295 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 15296 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 15297 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 15298 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 15299 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 15300 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 15301 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 15302 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 15303 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 15304 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 15305 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 15306 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 15307 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 15308 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 15309 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 15310 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 15311 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 15312 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 15313 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 15314 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 15315 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 15316 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 15317 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 15318 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 15319 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 15320 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 15321 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 15322 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 15323 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 15324 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 15325 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 15326 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 15327 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 15328 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 15329 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 15330 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 15331 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 15332 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 15333 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 15334 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 15335 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 15336 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 15337 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 15338 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 15339 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 15340 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 15341 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 15342 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 15343 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 15344 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 15345 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 15346 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 15347 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 15348 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 15349 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 15350 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 15351 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 15352 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 15353 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 15354 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 15355 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 15356 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 15357 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 15358 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 15359 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 15360 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 15361 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 15362 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 15363 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 15364 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 15365 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 15366 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 15367 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 15368 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 15369 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 15370 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 15371 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 15372 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 15373 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 15374 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 15375 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 15376 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 15377 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 15378 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 15379 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 15380 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 15381 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 15382 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 15383 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 15384 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 15385 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 15386 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 15387 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 15388 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 15389 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 15390 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 15391 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 15392 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 15393 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 15394 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 15395 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 15396 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 15397 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 15398 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 15399 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 15400 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 15401 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 15402 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 15403 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 15404 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 15405 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 15406 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 15407 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 15408 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 15409 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 15410 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 15411 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 15412 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 15413 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 15414 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 15415 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 15416 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 15417 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 15418 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 15419 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 15420 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 15421 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 15422 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 15423 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 15424 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 15425 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 15426 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 15427 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 15428 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 15429 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 15430 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 15431 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 15432 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 15433 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 15434 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 15435 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 15436 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 15437 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 15438 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 15439 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 15440 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 15441 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 15442 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 15443 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 15444 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 15445 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 15446 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 15447 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 15448 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 15449 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 15450 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 15451 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 15452 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 15453 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 15454 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 15455 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 15456 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 15457 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 15458 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 15459 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 15460 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 15461 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 15462 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 15463 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 15464 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 15465 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 15466 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 15467 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 15468 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 15469 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 15470 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 15471 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 15472 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 15473 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 15474 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 15475 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 15476 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 15477 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 15478 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 15479 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 15480 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 15481 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 15482 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 15483 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 15484 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 15485 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 15486 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 15487 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 15488 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 15489 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 15490 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 15491 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 15492 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 15493 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 15494 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 15495 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 15496 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 15497 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 15498 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 15499 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 15500 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 15501 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 15502 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 15503 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 15504 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 15505 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 15506 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 15507 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 15508 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 15509 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 15510 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 15511 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 15512 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 15513 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 15514 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 15515 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 15516 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 15517 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 15518 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 15519 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 15520 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 15521 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 15522 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 15523 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 15524 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 15525 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 15526 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 15527 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 15528 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 15529 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 15530 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 15531 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 15532 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 15533 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 15534 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 15535 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 15536 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 15537 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 15538 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 15539 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 15540 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 15541 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 15542 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 15543 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 15544 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 15545 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 15546 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 15547 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 15548 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 15549 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 15550 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 15551 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 15552 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 15553 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 15554 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 15555 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 15556 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 15557 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 15558 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 15559 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 15560 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 15561 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 15562 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 15563 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 15564 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 15565 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 15566 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 15567 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 15568 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 15569 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 15570 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 15571 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 15572 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 15573 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 15574 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 15575 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 15576 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 15577 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 15578 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 15579 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 15580 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 15581 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 15582 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 15583 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 15584 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 15585 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 15586 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 15587 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 15588 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 15589 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 15590 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 15591 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 15592 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 15593 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 15594 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 15595 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 15596 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 15597 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 15598 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 15599 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 15600 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 15601 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 15602 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 15603 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 15604 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 15605 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 15606 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 15607 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 15608 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 15609 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 15610 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 15611 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 15612 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 15613 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 15614 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 15615 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 15616 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 15617 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 15618 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 15619 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 15620 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 15621 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 15622 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 15623 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 15624 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 15625 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 15626 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 15627 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 15628 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 15629 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 15630 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 15631 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 15632 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 15633 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 15634 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 15635 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 15636 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 15637 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 15638 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 15639 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 15640 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 15641 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 15642 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 15643 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 15644 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 15645 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 15646 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 15647 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 15648 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 15649 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 15650 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 15651 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 15652 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 15653 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 15654 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 15655 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 15656 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 15657 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 15658 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 15659 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 15660 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 15661 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 15662 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 15663 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 15664 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 15665 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 15666 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 15667 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 15668 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 15669 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 15670 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 15671 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 15672 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 15673 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 15674 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 15675 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 15676 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 15677 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 15678 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 15679 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 15680 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 15681 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 15682 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 15683 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 15684 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 15685 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 15686 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 15687 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 15688 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 15689 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 15690 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 15691 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 15692 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 15693 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 15694 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 15695 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 15696 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 15697 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 15698 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 15699 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 15700 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 15701 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 15702 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 15703 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 15704 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 15705 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 15706 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 15707 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 15708 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 15709 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 15710 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 15711 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 15712 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 15713 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 15714 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 15715 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 15716 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 15717 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 15718 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 15719 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 15720 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 15721 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 15722 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 15723 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 15724 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 15725 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 15726 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 15727 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 15728 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 15729 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 15730 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 15731 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 15732 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 15733 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 15734 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 15735 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 15736 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 15737 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 15738 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 15739 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 15740 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 15741 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 15742 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 15743 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 15744 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 15745 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 15746 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 15747 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 15748 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 15749 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 15750 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 15751 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 15752 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 15753 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 15754 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 15755 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 15756 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 15757 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 15758 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 15759 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 15760 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 15761 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 15762 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 15763 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 15764 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 15765 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 15766 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 15767 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 15768 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 15769 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 15770 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 15771 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 15772 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 15773 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 15774 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 15775 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 15776 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 15777 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 15778 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 15779 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 15780 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 15781 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 15782 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 15783 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 15784 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 15785 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 15786 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 15787 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 15788 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 15789 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 15790 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 15791 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 15792 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 15793 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 15794 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 15795 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 15796 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 15797 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 15798 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 15799 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 15800 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 15801 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 15802 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 15803 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 15804 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 15805 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 15806 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 15807 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 15808 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 15809 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 15810 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 15811 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 15812 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 15813 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 15814 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 15815 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 15816 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 15817 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 15818 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 15819 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 15820 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 15821 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 15822 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 15823 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 15824 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 15825 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 15826 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 15827 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 15828 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 15829 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 15830 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 15831 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 15832 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 15833 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 15834 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 15835 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 15836 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 15837 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 15838 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 15839 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 15840 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 15841 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 15842 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 15843 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 15844 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 15845 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 15846 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 15847 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 15848 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 15849 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 15850 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 15851 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 15852 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 15853 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 15854 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 15855 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 15856 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 15857 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 15858 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 15859 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 15860 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 15861 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 15862 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 15863 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 15864 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 15865 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 15866 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 15867 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 15868 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 15869 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 15870 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 15871 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 15872 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 15873 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 15874 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 15875 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 15876 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 15877 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 15878 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 15879 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 15880 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 15881 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 15882 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 15883 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 15884 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 15885 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 15886 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 15887 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 15888 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 15889 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 15890 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 15891 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 15892 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 15893 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 15894 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 15895 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 15896 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 15897 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 15898 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 15899 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 15900 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 15901 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 15902 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 15903 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 15904 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 15905 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 15906 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 15907 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 15908 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 15909 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 15910 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 15911 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 15912 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 15913 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 15914 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 15915 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 15916 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 15917 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 15918 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 15919 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 15920 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 15921 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 15922 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 15923 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 15924 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 15925 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 15926 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 15927 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 15928 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 15929 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 15930 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 15931 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 15932 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 15933 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 15934 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 15935 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 15936 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 15937 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 15938 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 15939 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 15940 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 15941 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 15942 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 15943 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 15944 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 15945 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 15946 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 15947 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 15948 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 15949 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 15950 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 15951 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 15952 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 15953 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 15954 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 15955 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 15956 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 15957 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 15958 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 15959 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 15960 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 15961 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 15962 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 15963 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 15964 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 15965 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 15966 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 15967 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 15968 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 15969 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 15970 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 15971 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 15972 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 15973 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 15974 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 15975 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 15976 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 15977 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 15978 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 15979 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 15980 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 15981 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 15982 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 15983 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 15984 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 15985 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 15986 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 15987 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 15988 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 15989 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 15990 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 15991 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 15992 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 15993 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 15994 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 15995 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 15996 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 15997 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 15998 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 15999 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 16000 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 16001 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 16002 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 16003 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 16004 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 16005 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 16006 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 16007 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 16008 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 16009 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 16010 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 16011 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 16012 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 16013 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 16014 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 16015 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 16016 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 16017 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 16018 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 16019 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 16020 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 16021 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 16022 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 16023 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 16024 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 16025 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 16026 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 16027 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 16028 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 16029 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 16030 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 16031 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 16032 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 16033 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 16034 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 16035 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 16036 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 16037 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 16038 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 16039 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 16040 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 16041 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 16042 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 16043 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 16044 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 16045 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 16046 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 16047 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 16048 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 16049 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 16050 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 16051 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 16052 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 16053 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 16054 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 16055 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 16056 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 16057 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 16058 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 16059 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 16060 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 16061 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 16062 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 16063 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 16064 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 16065 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 16066 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 16067 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 16068 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 16069 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 16070 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 16071 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 16072 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 16073 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 16074 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 16075 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 16076 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 16077 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 16078 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 16079 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 16080 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 16081 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 16082 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 16083 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 16084 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 16085 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 16086 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 16087 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 16088 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 16089 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 16090 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 16091 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 16092 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 16093 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 16094 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 16095 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 16096 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 16097 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 16098 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 16099 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 16100 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 16101 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 16102 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 16103 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 16104 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 16105 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 16106 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 16107 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 16108 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 16109 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 16110 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 16111 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 16112 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 16113 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 16114 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 16115 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 16116 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 16117 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 16118 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 16119 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 16120 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 16121 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 16122 - protein, 189 aa, Artificial Sequence
  Artificially synthesized modified ADAM10 peptide
NPLNKYIRHYEGLSYNVDSLHQKHQRAKAAVSHEDAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK
